United States Patent 12,331,297 (COAGULATION FACTOR V (F5) iRNA COMPOSITIONS AND METHODS OF USE THEREOF) - sequence listing, part 2

SEQ ID NO: 2844 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acacgatttgcttgtcaaacgtc

SEQ ID NO: 2845 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agcacgatttgcttgtcaaacgt

SEQ ID NO: 2846 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aagcacgatttgcttgtcaaacg

SEQ ID NO: 2847 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acattgactgtgtacattaggga

SEQ ID NO: 2848 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
accattgactgtgtacattaggg

SEQ ID NO: 2849 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atccattgactgtgtacattagg

SEQ ID NO: 2850 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atgaaatgaatggagaataattc

SEQ ID NO: 2851 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agagaagatatgatccactttcc

SEQ ID NO: 2852 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atattttcttaagattcctggtt

SEQ ID NO: 2853 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agtattacaggtgcatagtccca

SEQ ID NO: 2854 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aggtattacaggtgcatagtccc

SEQ ID NO: 2855 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atggtattacaggtgcatagtcc

SEQ ID NO: 2856 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
actggtattacaggtgcatagtc

SEQ ID NO: 2857 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
attcgctggtattacaggtgcat

SEQ ID NO: 2858 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atattcgctggtattacaggtgc

SEQ ID NO: 2859 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aatattcgctggtattacaggtg

SEQ ID NO: 2860 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acatattcgctggtattacaggt

SEQ ID NO: 2861 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agtccatattcgctggtattaca

SEQ ID NO: 2862 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aagaaattatccaaatgctgaga

SEQ ID NO: 2863 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
attgaacacgattttgagtgtgt

SEQ ID NO: 2864 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aactctaagatgttccacttata

SEQ ID NO: 2865 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aactgtagtatggtcttgttaag

SEQ ID NO: 2866 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acctctttccatagatgaatgag

SEQ ID NO: 2867 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aagttaacatccaagttccaaca

SEQ ID NO: 2868 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aactagaattcatggaagttaac

SEQ ID NO: 2869 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agattcaatgatgagtttcggaa

SEQ ID NO: 2870 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aacaattatatctgtgtttgaag

SEQ ID NO: 2871 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agaagaataatttgaaccaacaa

SEQ ID NO: 2872 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aggaagaattgagaactgagttc

SEQ ID NO: 2873 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaccaagtgaaagtagacgtatc

SEQ ID NO: 2874 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaaatcttagatgagttactttg

SEQ ID NO: 2875 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aagatttatgtctaactctagga

SEQ ID NO: 2876 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atttcgtgtcttaatgagaaact

SEQ ID NO: 2877 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaaaatgtgttgtaggcttcact

SEQ ID NO: 2878 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaagagatgtttcattggattta

SEQ ID NO: 2879 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
actgaagtagagtgcatttgatc

SEQ ID NO: 2880 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agaaaagtatcattgagagtagg

SEQ ID NO: 2881 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aggattaaattcctttgatagaa

SEQ ID NO: 2882 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aataatcaatttcagcatagtca

SEQ ID NO: 2883 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atgtaataatttcttctgtttcc

SEQ ID NO: 2884 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atcacgtttggtaaaagtgctgt

SEQ ID NO: 2885 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atttaaaacgaacttggataaca

SEQ ID NO: 2886 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agctatttggctgaacagcatta

SEQ ID NO: 2887 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aatacgtaggtataactgctatt

SEQ ID NO: 2888 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaagtgaaccacgtgaatgtctt

SEQ ID NO: 2889 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaagagttttaaatgaaccaggc

SEQ ID NO: 2890 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atggcgtttgcatccctgctctc

SEQ ID NO: 2891 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aatggcgtttgcatccctgctct

SEQ ID NO: 2892 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agaaatggcgtttgcatccctgc

SEQ ID NO: 2893 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aagaaatggcgtttgcatccctg

SEQ ID NO: 2894 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaagaaatggcgtttgcatccct

SEQ ID NO: 2895 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
ataagaaatggcgtttgcatccc

SEQ ID NO: 2896 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agataagaaatggcgtttgcatc

SEQ ID NO: 2897 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aatgataagaaatggcgtttgca

SEQ ID NO: 2898 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acatgataagaaatggcgtttgc

SEQ ID NO: 2899 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
accatgataagaaatggcgtttg

SEQ ID NO: 2900 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atccatgataagaaatggcgttt

SEQ ID NO: 2901 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agtccatgataagaaatggcgtt

SEQ ID NO: 2902 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aataccagtgcttagtcccattg

SEQ ID NO: 2903 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agataccagtgcttagtcccatt

SEQ ID NO: 2904 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atgataccagtgcttagtcccat

SEQ ID NO: 2905 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aatgataccagtgcttagtccca

SEQ ID NO: 2906 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agatatgataccagtgcttagtc

SEQ ID NO: 2907 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acagatatgataccagtgcttag

SEQ ID NO: 2908 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atcagatatgataccagtgctta

SEQ ID NO: 2909 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aatcagatatgataccagtgctt

SEQ ID NO: 2910 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaatcagatatgataccagtgct

SEQ ID NO: 2911 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agtgaatcagatatgataccagt

SEQ ID NO: 2912 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acagtaacccagaaactctgaag

SEQ ID NO: 2913 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaaggtttagaggcaaattctgc

SEQ ID NO: 2914 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agtggtatagcaggacttcaggt

SEQ ID NO: 2915 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aagaactctgtggtatagcagga

SEQ ID NO: 2916 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atagaactctgtggtatagcagg

SEQ ID NO: 2917 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aatagaactctgtggtatagcag

SEQ ID NO: 2918 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acatagaactctgtggtatagca

SEQ ID NO: 2919 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atacatagaactctgtggtatag

SEQ ID NO: 2920 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agctacatagaactctgtggtat

SEQ ID NO: 2921 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aagctacatagaactctgtggta

SEQ ID NO: 2922 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atgtaagctacatagaactctgt

SEQ ID NO: 2923 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
actgtaagctacatagaactctg

SEQ ID NO: 2924 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aggaactgtaagctacatagaac

SEQ ID NO: 2925 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atggaactgtaagctacatagaa

SEQ ID NO: 2926 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
attggaactgtaagctacataga

SEQ ID NO: 2927 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
actggttggaactgtaagctaca

SEQ ID NO: 2928 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acattaaaatacatcacattcct

SEQ ID NO: 2929 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atatatctagccacaataggtgg

SEQ ID NO: 2930 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aatatatctagccacaataggtg

SEQ ID NO: 2931 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
ataatatatctagccacaatagg

SEQ ID NO: 2932 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
actaatatatctagccacaatag

SEQ ID NO: 2933 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acctaatatatctagccacaata

SEQ ID NO: 2934 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atcctaatatatctagccacaat

SEQ ID NO: 2935 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aatcctaatatatctagccacaa

SEQ ID NO: 2936 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aagatcctaatatatctagccac

SEQ ID NO: 2937 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agagatcctaatatatctagcca

SEQ ID NO: 2938 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
actttacatacatttcagaggac

SEQ ID NO: 2939 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aactgttaacatttaacacagcg

SEQ ID NO: 2940 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agagaaatagtggaaaactgtta

SEQ ID NO: 2941 - RNA, 23 nt, synthetic construct
  source 1..23: mol_type = other RNA
  modified_base 1: mod_base = OTHER; note = 2'-O-methyladenosine-3'-phosphorothioate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluoroguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
aataagaaatggcgtttgcatcc

SEQ ID NO: 2942 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
tataagaaatggcgtttgcatcc

SEQ ID NO: 2943 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..23: note = RNA
  misc_feature 2: note = DNA
  misc_feature 5: note = DNA
  misc_feature 7: note = DNA
tataagaaatggcgtttgcatcc

SEQ ID NO: 2944 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..9: note = RNA
  misc_feature 11..23: note = RNA
  misc_feature 2: note = DNA
  misc_feature 5: note = DNA
  misc_feature 7: note = DNA
  misc_feature 10: note = DNA
tataagaaatggcgtttgcatcc

SEQ ID NO: 2945 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..9: note = RNA
  misc_feature 11..23: note = RNA
  misc_feature 2: note = DNA
  misc_feature 5: note = DNA
  misc_feature 7: note = DNA
  misc_feature 10: note = DNA
tataagaaatggcgattgcatcc

SEQ ID NO: 2946 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..9: note = RNA
  misc_feature 11..23: note = RNA
  misc_feature 2: note = DNA
  misc_feature 5: note = DNA
  misc_feature 7: note = DNA
  misc_feature 10: note = DNA
tataagaaatggcgtatgcatcc

SEQ ID NO: 2947 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..9: note = RNA
  misc_feature 11..23: note = RNA
  misc_feature 2: note = DNA
  misc_feature 5: note = DNA
  misc_feature 7: note = DNA
  misc_feature 10: note = DNA
tataagaaatggcgttagcatcc

SEQ ID NO: 2948 - DNA, 21 bp, synthetic construct
  source 1..21: mol_type = other DNA
  modified_base 1: mod_base = OTHER; note = 2'-O-methyluridine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphorothioate
  modified_base 20: mod_base = OTHER; note = 2'-O-methylguanosine-3'-phosphorothioate
  modified_base 21: mod_base = OTHER; note = 2'-O-methyluridine
  misc_feature 1: note = RNA
  misc_feature 3..4: note = RNA
  misc_feature 6: note = RNA
  misc_feature 8..9: note = RNA
  misc_feature 11..21: note = RNA
  misc_feature 2: note = DNA
  misc_feature 5: note = DNA
  misc_feature 7: note = DNA
  misc_feature 10: note = DNA
tataagaaatggcgtttgcgt

SEQ ID NO: 2949 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphorothioate
  modified_base 20: mod_base = OTHER; note = 2'-O-methylguanosine-3'-phosphorothioate
  modified_base 21: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..21: note = RNA
  misc_feature 2: note = DNA
  misc_feature 5: note = DNA
  misc_feature 7: note = DNA
  misc_feature 12: note = DNA
aataagaaatggcgtttgcgt

SEQ ID NO: 2950 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aataagaaatggcgattgcatcc

SEQ ID NO: 2951 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aataagaaatggcgtatgcatcc

SEQ ID NO: 2952 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aataagaaatggcgttagcatcc

SEQ ID NO: 2953 - DNA, 21 bp, synthetic construct
  source 1..21: mol_type = other DNA
  modified_base 1: mod_base = OTHER; note = 2'-O-methyluridine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphorothioate
  modified_base 20: mod_base = OTHER; note = 2'-O-methylguanosine-3'-phosphorothioate
  modified_base 21: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..21: note = RNA
  misc_feature 2: note = DNA
  misc_feature 5: note = DNA
  misc_feature 7: note = DNA
  misc_feature 12: note = DNA
tataagaaatggcgtttgcgt

SEQ ID NO: 2954 - DNA, 23 bp, synthetic construct
  source 1..23: mol_type = other DNA
  modified_base 1: mod_base = OTHER; note = 2'-O-methyluridine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
tataagaaatggcgtatgcatcc

SEQ ID NO: 2955 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaataaatgtgtgtgaggcatgg

SEQ ID NO: 2956 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agaataatagatgtgtgtgaggc

SEQ ID NO: 2957 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agagaaatagatgtgtgtgaggc

SEQ ID NO: 2958 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aatccaatgactgtgtacattag

SEQ ID NO: 2959 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
ataatgtcaatgtaagcctgcat

SEQ ID NO: 2960 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
ataatatcaatgtaagcctgcat

SEQ ID NO: 2961 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
ataatgacaatgtaagcctgcat

SEQ ID NO: 2962 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1..4: note = RNA
  misc_feature 6: note = RNA
  misc_feature 8..23: note = RNA
  misc_feature 5: note = DNA
  misc_feature 7: note = DNA
attaatgtcaatgtaagcctgca

SEQ ID NO: 2963 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1..4: note = RNA
  misc_feature 6: note = RNA
  misc_feature 8..23: note = RNA
  misc_feature 5: note = DNA
  misc_feature 7: note = DNA
attaaagtcaatgtaagcctgca

SEQ ID NO: 2964 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1..4: note = RNA
  misc_feature 6: note = RNA
  misc_feature 8..23: note = RNA
  misc_feature 5: note = DNA
  misc_feature 7: note = DNA
attaatatcaatgtaagcctgca

SEQ ID NO: 2965 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylguanosine
  misc_feature 1..4: note = RNA
  misc_feature 6: note = RNA
  misc_feature 8..23: note = RNA
  misc_feature 5: note = DNA
  misc_feature 7: note = DNA
attaatgtcaatgtaagcctgcg

SEQ ID NO: 2966 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylguanosine
  misc_feature 1..4: note = RNA
  misc_feature 6: note = RNA
  misc_feature 8..23: note = RNA
  misc_feature 5: note = DNA
  misc_feature 7: note = DNA
attaaagtcaatgtaagcctgcg

SEQ ID NO: 2967 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylguanosine
  misc_feature 1..4: note = RNA
  misc_feature 6: note = RNA
  misc_feature 8..23: note = RNA
  misc_feature 5: note = DNA
  misc_feature 7: note = DNA
attaatatcaatgtaagcctgcg

SEQ ID NO: 2968 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acagtatttaatgtcaatgtaag

SEQ ID NO: 2969 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acagttattaatgtcaatgtaag

SEQ ID NO: 2970 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aattcactggtattacaggtgca

SEQ ID NO: 2971 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aattcgatggtattacaggtgca

SEQ ID NO: 2972 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aattcactggtattacaggtgcg

SEQ ID NO: 2973 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aattcgatggtattacaggtgcg

SEQ ID NO: 2974 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaataggaccaagaattccgaga

SEQ ID NO: 2975 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaataagaccaagaattccgaga

SEQ ID NO: 2976 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaatagaaccaagaattccgaga

SEQ ID NO: 2977 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaataggaccaagaattccgagg

SEQ ID NO: 2978 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaataagaccaagaattccgagg

SEQ ID NO: 2979 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaatagaaccaagaattccgagg

SEQ ID NO: 2980 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acataataccagctcttcttttc

SEQ ID NO: 2981 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
acatagaaccagctcttcttttc

SEQ ID NO: 2982 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aagataagataccagtgcttagt

SEQ ID NO: 2983 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aagaaatctgtggtatagcagga

SEQ ID NO: 2984 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aagaacactgtggtatagcagga

SEQ ID NO: 2985 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aagaactctgtggtatagcaggg

SEQ ID NO: 2986 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aagaaatctgtggtatagcaggg

SEQ ID NO: 2987 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aagaacactgtggtatagcaggg

SEQ ID NO: 2988 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
atgtaaactacatagaactctgt

SEQ ID NO: 2989 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aggaaatgtaagctacatagaac

SEQ ID NO: 2990 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aggaacagtaagctacatagaac

SEQ ID NO: 2991 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaataaatctagccacaataggt

SEQ ID NO: 2992 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaaaaacttgtccaccatggagg

SEQ ID NO: 2993 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aaaaatattgtccaccatggagg

SEQ ID NO: 2994 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agtatttccttcaaaaatcttgt

SEQ ID NO: 2995 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agtatatccttcaaaaatcttgt

SEQ ID NO: 2996 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
agtattaccttcaaaaatcttgt

SEQ ID NO: 2997 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aagtaattccttcaaaaatcttg

SEQ ID NO: 2998 - DNA, 23 bp, synthetic construct
  source 1..23: mol_type = other DNA
  modified_base 1: mod_base = OTHER; note = 2'-O-methyladenosine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
aagtatatccttcaaaaatcttg

SEQ ID NO: 2999 - RNA, 23 nt, synthetic construct
  source 1..23: mol_type = other RNA
  modified_base 1: mod_base = OTHER; note = 2'-O-methyluridine-3'-phosphorothioate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-deoxy-2'-fluorouridine-3'-phosphate
  modified_base 7: mod_base = OTHER; note = 2'-O-methylguanosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorocytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
tttaatgtcaatgtaagcctgca

SEQ ID NO: 3000 - RNA, 23 nt, synthetic construct
  source 1..23: mol_type = other RNA
caagaactcagttctcaattctt

SEQ ID NO: 3001 - RNA, 23 nt, synthetic construct
  source 1..23: mol_type = other RNA
tctcctactctcaatgatacttt

SEQ ID NO: 3002 - RNA, 23 nt, synthetic construct
  source 1..23: mol_type = other RNA
agacacactcaaaatcgtgttca

SEQ ID NO: 3003 - RNA, 23 nt, synthetic construct
  source 1..23: mol_type = other RNA
atgttaacttccatgaattctag

SEQ ID NO: 3004 - RNA, 23 nt, synthetic construct
  source 1..23: mol_type = other RNA
tcctactctcaatgatacttttc

SEQ ID NO: 3005 - RNA, 23 nt, synthetic construct
  source 1..23: mol_type = other RNA
ttaacagttttccactatttctc

SEQ ID NO: 3006 - RNA, 23 nt, synthetic construct
  source 1..23: mol_type = other RNA
ggcaggatctctcttgatctaga

SEQ ID NO: 3007 - RNA, 23 nt, synthetic construct
  source 1..23: mol_type = other RNA
acatcataaaagttcactttaaa

SEQ ID NO: 3008 - RNA, 23 nt, synthetic construct
  source 1..23: mol_type = other RNA
tcataaaagttcactttaaaaat

SEQ ID NO: 3009 - RNA, 23 nt, synthetic construct
  source 1..23: mol_type = other RNA
ttattctccattcatttcaacgg

SEQ ID NO: 3010 - RNA, 23 nt, synthetic construct
  source 1..23: mol_type = other RNA
atgatcagagcagttcaaccagg

SEQ ID NO: 3011 - RNA, 23 nt, synthetic construct
  source 1..23: mol_type = other RNA
aacatcatgagcactatcaatgg

SEQ ID NO: 3012 - RNA, 23 nt, synthetic construct
  source 1..23: mol_type = other RNA
aagactcatatgagatttttgaa

SEQ ID NO: 3013 - RNA, 23 nt, synthetic construct
  source 1..23: mol_type = other RNA
tacacggaaaatgcatgatcgtt

SEQ ID NO: 3014 - RNA, 23 nt, synthetic construct
  source 1..23: mol_type = other RNA
gaaagaggcatgaggacaccttg

SEQ ID NO: 3015 - RNA, 23 nt, synthetic construct
  source 1..23: mol_type = other RNA
cttccccaagtaatattagtaag

SEQ ID NO: 3016 - RNA, 23 nt, synthetic construct
  source 1..23: mol_type = other RNA
ggtaccttgaggacaacatcaac

SEQ ID NO: 3017 - RNA, 23 nt, synthetic construct
  source 1..23: mol_type = other RNA
aattcttccacagcagagcattc

SEQ ID NO: 3018 - RNA, 23 nt, synthetic construct
  source 1..23: mol_type = other RNA
attgatctggaaaatacttgttt

SEQ ID NO: 3019 - RNA, 23 nt, synthetic construct
  source 1..23: mol_type = other RNA
cacttcactgggcactcattcat

SEQ ID NO: 3020 - RNA, 23 nt, synthetic construct
  source 1..23: mol_type = other RNA
cttcactgggcactcattcatct

SEQ ID NO: 3021 - RNA, 23 nt, synthetic construct
  source 1..23: mol_type = other RNA
atgactatgctgaaattgattat

SEQ ID NO: 3022 - RNA, 23 nt, synthetic construct
  source 1..23: mol_type = other RNA
gatgccatctccttcatctccta

SEQ ID NO: 3023 - RNA, 23 nt, synthetic construct
  source 1..23: mol_type = other RNA
aagatgaagtcaactcttctttc

SEQ ID NO: 3024 - RNA, 23 nt, synthetic construct
  source 1..23: mol_type = other RNA
gaagtcaactcttctttcacctc

SEQ ID NO: 3025 - RNA, 23 nt, synthetic construct
  source 1..23: mol_type = other RNA
aaaaaaacagccaagcatctttc

SEQ ID NO: 3026 - RNA, 23 nt, synthetic construct
  source 1..23: mol_type = other RNA
agttagacataaatctctacaag

SEQ ID NO: 3027 - RNA, 23 nt, synthetic construct
  source 1..23: mol_type = other RNA
gtctttcccatataacaatgatt

SEQ ID NO: 3028 - RNA, 23 nt, synthetic construct
  source 1..23: mol_type = other RNA
gaatcaggtcattccgaaactca

SEQ ID NO: 3029 - RNA, 23 nt, synthetic construct
  source 1..23: mol_type = other RNA
tcttcaaacacagatataattgt

SEQ ID NO: 3030 - RNA, 23 nt, synthetic construct
  source 1..23: mol_type = other RNA
acaagcaaatcacagcttcttcg

SEQ ID NO: 3031 - RNA, 23 nt, synthetic construct
  source 1..23: mol_type = other RNA
attcgttggtgcttcataaatcc

SEQ ID NO: 3032 - RNA, 23 nt, synthetic construct
  source 1..23: mol_type = other RNA
cataatcagaattcctcaaatga

SEQ ID NO: 3033 - RNA, 23 nt, synthetic construct
  source 1..23: mol_type = other RNA
tagaattgaacattcaaaaaccc

SEQ ID NO: 3034 - RNA, 21 nt, synthetic construct
  source 1..21: mol_type = other RNA
atgcaaacgccatttcttatc
